United States Patent 10,724,025 (PENICILLIN-G ACYLASES) - sequence listing, part 2

SEQ ID NO: 1577 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgtggggcttcctgtggggctgtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagtggtacagcgccagtggctatgaaaccacccagtttgggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1578 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVWGFLWGCADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKWYSASGYETTQFGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1579 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatccggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgtgggcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagtggtacagcgccagtggctatgaaaccacccagtttgggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1580 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDPVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVWAFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKWYSASGYETTQFGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1581 - DNA, 2295 bp, Artificial Sequence; identical to SEQ ID NO: 1317
  Penicillin-G Acylates Variant from K. citrophila

SEQ ID NO: 1582 - protein, 764 aa, Artificial Sequence; identical to SEQ ID NO: 1318
  Penicillin-G Acylates Variant from K. citrophila

SEQ ID NO: 1583 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatggcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggttgcatttacagcgccagtggctatgaaaccacccagtttgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1584 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVFAFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGCIYSASGYETTQFGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1585 - DNA, 2295 bp, Artificial Sequence; identical to SEQ ID NO: 1451
  Penicillin-G Acylates Variant from K. citrophila

SEQ ID NO: 1586 - protein, 764 aa, Artificial Sequence; identical to SEQ ID NO: 1452
  Penicillin-G Acylates Variant from K. citrophila

SEQ ID NO: 1587 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatggcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgttcggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagtggtacagcgccagtggctatgaaaccacccaggacgggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1588 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVFGFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKWYSASGYETTQDGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1589 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgataacgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgttcggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagatttacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1590 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDNVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVFGFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKIYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1591 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgataacgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagatttacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1592 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDNVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFGFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKIYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1593 - DNA, 2295 bp, Artificial Sequence; identical to SEQ ID NO: 1507
  Penicillin-G Acylates Variant from K. citrophila

SEQ ID NO: 1594 - protein, 764 aa, Artificial Sequence; identical to SEQ ID NO: 1508
  Penicillin-G Acylates Variant from K. citrophila

SEQ ID NO: 1595 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1596 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1597 - DNA, 2295 bp, Artificial Sequence; identical to SEQ ID NO: 1551
  Penicillin-G Acylates Variant from K. citrophila

SEQ ID NO: 1598 - protein, 764 aa, Artificial Sequence; identical to SEQ ID NO: 1552
  Penicillin-G Acylates Variant from K. citrophila

SEQ ID NO: 1599 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtggggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagatttacagcgccagtggctatgaaaccacccagtgggggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1600 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLWGFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKIYSASGYETTQWGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1601 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgttcggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggttgcatttacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1602 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVFGFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGCIYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1603 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccagtttgggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1604 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQFGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1605 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatagcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagtggtacagcgccagtggctatgaaaccacccagaaagggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1606 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDSVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFGFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKWYSASGYETTQKGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1607 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatccggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgtgggcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagatttacagcgccagtggctatgaaaccacccagtgggggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1608 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDPVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVWAFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKIYSASGYETTQWGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1609 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgtggggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagatttacagcgccagtggctatgaaaccacccaggacgggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1610 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVWGFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKIYSASGYETTQDGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1611 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagatttacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1612 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFGFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKIYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1613 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatggcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtgggcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagtggtacagcgccagtggctatgaaaccacccagtgggggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1614 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLWAFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKWYSASGYETTQWGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1615 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtggggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccagaaagggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1616 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLWGFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQKGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1617 - DNA, 2295 bp, Artificial Sequence; identical to SEQ ID NO: 1351
  Penicillin-G Acylates Variant from K. citrophila

SEQ ID NO: 1618 - protein, 764 aa, Artificial Sequence; identical to SEQ ID NO: 1352
  Penicillin-G Acylates Variant from K. citrophila

SEQ ID NO: 1619 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatccggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgtgggcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggttgctggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1620 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDPVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVWAFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGCWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1621 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatagcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtgggcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagtggtacagcgccagtggctatgaaaccacccagtttgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1622 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDSVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLWAFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKWYSASGYETTQFGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1623 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgataacgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtggggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggttgctggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1624 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDNVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLWGFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGCWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1625 - DNA, 2295 bp, Artificial Sequence; identical to SEQ ID NO: 1429
  Penicillin-G Acylates Variant from K. citrophila

SEQ ID NO: 1626 - protein, 764 aa, Artificial Sequence; identical to SEQ ID NO: 1430
  Penicillin-G Acylates Variant from K. citrophila

SEQ ID NO: 1627 - DNA, 2295 bp, Artificial Sequence; identical to SEQ ID NO: 1427
  Penicillin-G Acylates Variant from K. citrophila

SEQ ID NO: 1628 - protein, 764 aa, Artificial Sequence; identical to SEQ ID NO: 1428
  Penicillin-G Acylates Variant from K. citrophila

SEQ ID NO: 1629 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtgggcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggttgctggtacagcgccagtggctatgaaaccacccagtttgggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1630 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLWAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGCWYSASGYETTQFGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1631 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgtgggcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagatttacagcgccagtggctatgaaaccacccagtttgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1632 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVWAFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKIYSASGYETTQFGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1633 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatggcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgttcggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1634 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVFGFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1635 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgataacgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgtgggcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagatttacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1636 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDNVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVWAFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKIYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1637 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggttgcatttacagcgccagtggctatgaaaccacccagaaagggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1638 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGCIYSASGYETTQKGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1639 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgataacgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgtgggcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggttgcatttacagcgccagtggctatgaaaccacccagaaagggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1640 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDNVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVWAFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGCIYSASGYETTQKGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1641 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtgggcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggttgcatttacagcgccagtggctatgaaaccacccagaatgggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1642 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLWAFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGCIYSASGYETTQNGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1643 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatggcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgtggggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggttgcatttacagcgccagtggctatgaaaccacccagtttgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1644 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVWGFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGCIYSASGYETTQFGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1645 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatggcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgtgggcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggttgcatttacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1646 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVWAFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGCIYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1647 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagtggtacagcgccagtggctatgaaaccacccagtgggggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1648 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFGFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKWYSASGYETTQWGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1649 - DNA, 2295 bp, Artificial Sequence; identical to SEQ ID NO: 1379
  Penicillin-G Acylates Variant from K. citrophila

SEQ ID NO: 1650 - protein, 764 aa, Artificial Sequence; identical to SEQ ID NO: 1380
  Penicillin-G Acylates Variant from K. citrophila

SEQ ID NO: 1651 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtgggcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagtggtacagcgccagtggctatgaaaccacccagtgggggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1652 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLWAFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKWYSASGYETTQWGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1653 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatggcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1654 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1655 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgataacgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1656 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDNVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1657 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatggcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgtggggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1658 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVWGFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1659 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatggcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtggggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggttgcatttacagcgccagtggctatgaaaccacccagaaagggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1660 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLWGFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGCIYSASGYETTQKGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1661 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtggggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1662 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLWGFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1663 - DNA, 2295 bp, Artificial Sequence; identical to SEQ ID NO: 1369
  Penicillin-G Acylates Variant from K. citrophila

SEQ ID NO: 1664 - protein, 764 aa, Artificial Sequence; identical to SEQ ID NO: 1370
  Penicillin-G Acylates Variant from K. citrophila

SEQ ID NO: 1665 - DNA, 2295 bp, Artificial Sequence; identical to SEQ ID NO: 1481
  Penicillin-G Acylates Variant from K. citrophila

SEQ ID NO: 1666 - protein, 764 aa, Artificial Sequence; identical to SEQ ID NO: 1482
  Penicillin-G Acylates Variant from K. citrophila

SEQ ID NO: 1667 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgtggggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagtggtacagcgccagtggctatgaaaccacccagtttgggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1668 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVWGFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKWYSASGYETTQFGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1669 - DNA, 2295 bp, Artificial Sequence; identical to SEQ ID NO: 1547
  Penicillin-G Acylates Variant from K. citrophila

SEQ ID NO: 1670 - protein, 764 aa, Artificial Sequence; identical to SEQ ID NO: 1548
  Penicillin-G Acylates Variant from K. citrophila

SEQ ID NO: 1671 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgataacgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtgggcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1672 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDNVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLWAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1673 - DNA, 2295 bp, Artificial Sequence; identical to SEQ ID NO: 1355
  Penicillin-G Acylates Variant from K. citrophila

SEQ ID NO: 1674 - protein, 764 aa, Artificial Sequence; identical to SEQ ID NO: 1356
  Penicillin-G Acylates Variant from K. citrophila

SEQ ID NO: 1675 - DNA, 2295 bp, Artificial Sequence; identical to SEQ ID NO: 1415
  Penicillin-G Acylates Variant from K. citrophila

SEQ ID NO: 1676 - protein, 764 aa, Artificial Sequence; identical to SEQ ID NO: 1416
  Penicillin-G Acylates Variant from K. citrophila

SEQ ID NO: 1677 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtgggcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggtgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1678 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLWAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEVRHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1679 - DNA, 2295 bp, Artificial Sequence; identical to SEQ ID NO: 1487
  Penicillin-G Acylates Variant from K. citrophila

SEQ ID NO: 1680 - protein, 764 aa, Artificial Sequence; identical to SEQ ID NO: 1488
  Penicillin-G Acylates Variant from K. citrophila

SEQ ID NO: 1681 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgataacgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggttgctggtacagcgccagtggctatgaaaccacccagaaagggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1682 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDNVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGCWYSASGYETTQKGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1683 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatggcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgttcggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagtggtacagcgccagtggctatgaaaccacccagtttgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1684 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVFGFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKWYSASGYETTQFGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1685 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagatttacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1686 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFGFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKIYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1687 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatagcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtggggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1688 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDSVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLWGFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1689 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtggggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagatttacagcgccagtggctatgaaaccacccagaaagggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1690 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLWGFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKIYSASGYETTQKGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1691 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgataacgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgtgggcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1692 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDNVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVWAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1693 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatagcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgtgggcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagtggtacagcgccagtggctatgaaaccacccagtgggggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1694 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDSVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVWAFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKWYSASGYETTQWGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1695 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgataacgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtggggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1696 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDNVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLWGFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1697 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatccggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgtggggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1698 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDPVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVWGFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1699 - DNA, 2295 bp, Artificial Sequence; identical to SEQ ID NO: 1657
  Penicillin-G Acylates Variant from K. citrophila

SEQ ID NO: 1700 - protein, 764 aa, Artificial Sequence; identical to SEQ ID NO: 1658
  Penicillin-G Acylates Variant from K. citrophila

SEQ ID NO: 1701 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatagcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtggggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggttgctggtacagcgccagtggctatgaaaccacccaggacgggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1702 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDSVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLWGFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGCWYSASGYETTQDGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1703 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgataacgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgtgggcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggttgctggtacagcgccagtggctatgaaaccacccaggacgggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1704 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDNVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVWAFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGCWYSASGYETTQDGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1705 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagatttacagcgccagtggctatgaaaccacccagtttgggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1706 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVFAFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKIYSASGYETTQFGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1707 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagatttacagcgccagtggctatgaaaccacccagaaagggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1708 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFGFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKIYSASGYETTQKGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1709 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatagcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagatttacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1710 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDSVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFGFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKIYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1711 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccagtttgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1712 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQFGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1713 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactagtacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1714 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTSTQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1715 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgatgaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1716 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATMTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1717 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaatggattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1718 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKWIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1719 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatcgtttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1720 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDRFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1721 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagatgtactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1722 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQMYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1723 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagcgttactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1724 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQRYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1725 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaaaatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1726 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKNIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1727 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatcttgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1728 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDLATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1729 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcgttgcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1730 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGVAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1731 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccagttggggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1732 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQLGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1733 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccagcgtgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1734 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQRGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1735 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactggtacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1736 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTGTQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1737 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcaagtaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1738 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAASKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1739 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatcctgatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1740 - protein, 764 aa, Artificial Sequence; identical to SEQ ID NO: 1284
  Penicillin-G Acylates Variant from K. citrophila

SEQ ID NO: 1741 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgtatctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1742 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAYLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1743 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagttattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1744 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKVIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1745 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggccatgcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1746 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGHAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1747 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagcaattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1748 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKAIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1749 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccagcaagggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1750 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQQGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1751 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaaggtttacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1752 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKVYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1753 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggctgtgcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1754 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGCAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1755 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccacgtggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1756 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPRGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1757 - DNA, 2295 bp, Artificial Sequence; identical to SEQ ID NO: 1725
  Penicillin-G Acylates Variant from K. citrophila

SEQ ID NO: 1758 - protein, 764 aa, Artificial Sequence; identical to SEQ ID NO: 1726
  Penicillin-G Acylates Variant from K. citrophila

SEQ ID NO: 1759 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatatgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1760 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDMFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1761 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgcatctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1762 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAHLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1763 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaacgtttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1764 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKRFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1765 - DNA, 2295 bp, Artificial Sequence; identical to SEQ ID NO: 1733
  Penicillin-G Acylates Variant from K. citrophila

SEQ ID NO: 1766 - protein, 764 aa, Artificial Sequence; identical to SEQ ID NO: 1734
  Penicillin-G Acylates Variant from K. citrophila

SEQ ID NO: 1767 - DNA, 2295 bp, Artificial Sequence; identical to SEQ ID NO: 1725
  Penicillin-G Acylates Variant from K. citrophila

SEQ ID NO: 1768 - protein, 764 aa, Artificial Sequence; identical to SEQ ID NO: 1726
  Penicillin-G Acylates Variant from K. citrophila

SEQ ID NO: 1769 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaggggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1770 - protein, 764 aa, Artificial Sequence; identical to SEQ ID NO: 1756
  Penicillin-G Acylates Variant from K. citrophila

SEQ ID NO: 1771 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaacttattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1772 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKLIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1773 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgctttgtttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1774 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALCFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1775 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggttgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1776 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQVGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1777 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccagaaagggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1778 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQKGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1779 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccagtttgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttacccaagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1780 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQFGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPKQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1781 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaatatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1782 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKYIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1783 - DNA, 2295 bp, Artificial Sequence; identical to SEQ ID NO: 1287
  Penicillin-G Acylates Variant from K. citrophila

SEQ ID NO: 1784 - protein, 764 aa, Artificial Sequence; identical to SEQ ID NO: 1284
  Penicillin-G Acylates Variant from K. citrophila

SEQ ID NO: 1785 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaacgtattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1786 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKRIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1787 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaatttattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1788 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKFIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1789 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaaaaaattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1790 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKKIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1791 - DNA, 2295 bp, Artificial Sequence; identical to SEQ ID NO: 1781
  Penicillin-G Acylates Variant from K. citrophila

SEQ ID NO: 1792 - protein, 764 aa, Artificial Sequence; identical to SEQ ID NO: 1782
  Penicillin-G Acylates Variant from K. citrophila

SEQ ID NO: 1793 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccagattgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1794 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQIGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1795 - DNA, 2295 bp, Artificial Sequence; identical to SEQ ID NO: 1725
  Penicillin-G Acylates Variant from K. citrophila

SEQ ID NO: 1796 - protein, 764 aa, Artificial Sequence; identical to SEQ ID NO: 1726
  Penicillin-G Acylates Variant from K. citrophila

SEQ ID NO: 1797 - DNA, 2295 bp, Artificial Sequence; identical to SEQ ID NO: 1755
  Penicillin-G Acylates Variant from K. citrophila

SEQ ID NO: 1798 - protein, 764 aa, Artificial Sequence; identical to SEQ ID NO: 1756
  Penicillin-G Acylates Variant from K. citrophila

SEQ ID NO: 1799 - DNA, 2295 bp, Artificial Sequence; identical to SEQ ID NO: 1725
  Penicillin-G Acylates Variant from K. citrophila

SEQ ID NO: 1800 - protein, 764 aa, Artificial Sequence; identical to SEQ ID NO: 1726
  Penicillin-G Acylates Variant from K. citrophila

SEQ ID NO: 1801 - DNA, 2295 bp, Artificial Sequence; identical to SEQ ID NO: 1785
  Penicillin-G Acylates Variant from K. citrophila

SEQ ID NO: 1802 - protein, 764 aa, Artificial Sequence; identical to SEQ ID NO: 1786
  Penicillin-G Acylates Variant from K. citrophila

SEQ ID NO: 1803 - DNA, 2295 bp, Artificial Sequence; identical to SEQ ID NO: 1749
  Penicillin-G Acylates Variant from K. citrophila

SEQ ID NO: 1804 - protein, 764 aa, Artificial Sequence; identical to SEQ ID NO: 1750
  Penicillin-G Acylates Variant from K. citrophila

SEQ ID NO: 1805 - DNA, 2295 bp, Artificial Sequence; identical to SEQ ID NO: 1755
  Penicillin-G Acylates Variant from K. citrophila

SEQ ID NO: 1806 - protein, 764 aa, Artificial Sequence; identical to SEQ ID NO: 1756
  Penicillin-G Acylates Variant from K. citrophila

SEQ ID NO: 1807 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcatttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1808 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVIFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1809 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgttttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1810 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1811 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatagtttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1812 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDSFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1813 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaaaggattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1814 - protein, 764 aa, Artificial Sequence; identical to SEQ ID NO: 1786
  Penicillin-G Acylates Variant from K. citrophila

SEQ ID NO: 1815 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctggaaatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1816 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLEISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1817 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccacaaacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1818 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRATNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1819 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgcagccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccaccccagacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1820 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRSQLVDKLASWDGENLVNDDGKTYQQPGSAILNAWLTSMLKRTVVAAVPAPFGKWYSASGYETTPDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1821 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagctatagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1822 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSYSGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1823 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcaaaagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1824 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSKSGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1825 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccaaagaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1826 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTKEIDNLALLTALKDKYGKQQGMAVFNQLKWLVNPSAPTTIAARESAYPLKFDLQNTQTA

SEQ ID NO: 1827 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagtcgtgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1828 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSRDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1829 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaaagcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcaacaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1830 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILKAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAATKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1831 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattggtaacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1832 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIGNLALLTALKDKYGKQQGMAVFNQLKWLVNPSAPTTIAARESAYPLKFDLQNTQTA

SEQ ID NO: 1833 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgcaaacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1834 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIANLALLTALKDKYGKQQGMAVFNQLKWLVNPSAPTTIAARESAYPLKFDLQNTQTA

SEQ ID NO: 1835 - DNA, 2295 bp, Artificial Sequence; identical to SEQ ID NO: 1827
  Penicillin-G Acylates Variant from K. citrophila

SEQ ID NO: 1836 - protein, 764 aa, Artificial Sequence; identical to SEQ ID NO: 1828
  Penicillin-G Acylates Variant from K. citrophila

SEQ ID NO: 1837 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattaataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1838 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEINNLALLTALKDKYGKQQGMAVFNQLKWLVNPSAPTTIAARESAYPLKFDLQNTQTA

SEQ ID NO: 1839 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgaaacagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1840 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTAKQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1841 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattcataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1842 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIHNLALLTALKDKYGKQQGMAVFNQLKWLVNPSAPTTIAARESAYPLKFDLQNTQTA

SEQ ID NO: 1843 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgcaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1844 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYATTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1845 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagtaaagataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1846 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSKDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1847 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagggaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1848 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTREIDNLALLTALKDKYGKQQGMAVFNQLKWLVNPSAPTTIAARESAYPLKFDLQNTQTA

SEQ ID NO: 1849 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattaggaacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1850 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIRNLALLTALKDKYGKQQGMAVFNQLKWLVNPSAPTTIAARESAYPLKFDLQNTQTA

SEQ ID NO: 1851 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcgtcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1852 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARRQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1853 - DNA, 2295 bp, Artificial Sequence
  Penicillin-G Acylates Variant from K. citrophila
agcaatatgtgggtgattggcaaaaacaaagcccaggatgcgaaggccattatggtcagtgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattcaaaacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1854 - protein, 764 aa, Artificial Sequence
  Penicillin-G Acylates Variant from K. citrophila
SNMWVIGKNKAQDAKAIMVSGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIQNLALLTALKDKYGKQQGMAVFNQLKWLVNPSAPTTIAARESAYPLKFDLQNTQTA

SEQ ID NO: 1855 - DNA, 2295 bp, Artificial Sequence; identical to SEQ ID NO: 1827
  Penicillin-G Acylates Variant from K. citrophila

SEQ ID NO: 1856 - protein, 764 aa, Artificial Sequence; identical to SEQ ID NO: 1828
  Penicillin-G Acylates Variant from K. citrophila

SEQ ID NO: 1857 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattagtaacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1858 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEISNLALLTALKDKYGKQQGMAVFNQLKWLVNPSAPTTIAARESAYPLKFDLQNTQTA

SEQ ID NO: 1859 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcatttggaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1860 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIWTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1861 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcgaaagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1862 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSESEIDNLALLTALKDKYGKQQGMAVFNQLKWLVNPSAPTTIAARESAYPLKFDLQNTQTA

SEQ ID NO: 1863 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgacagcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1864 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLTAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1865 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcccattcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1866 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFPFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1867 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattctgtagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1868 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFCSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1869 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgaattcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1870 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFEFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1871 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccatgggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1872 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTMGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1873 - DNA, 2295 bp, Artificial Sequence; identical to SEQ ID NO: 1863
  Penicillin-G Acylates Variant from K. citrophila

SEQ ID NO: 1874 - protein, 764 aa, Artificial Sequence; identical to SEQ ID NO: 1864
  Penicillin-G Acylates Variant from K. citrophila

SEQ ID NO: 1875 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgaaagcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1876 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLKAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1877 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgcaggtgggggtgatgatgtcgatatctttgccgaaaaactttccgtcgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1878 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSVEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1879 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtcattctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1880 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRHSDSTSEIDNLALLTALKDKYGKQQGMAVFNQLKWLVNPSAPTTIAARESAYPLKFDLQNTQTA

SEQ ID NO: 1881 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggaaaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1882 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGKTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1883 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccacccttggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1884 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTLGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1885 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaagttgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1886 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEVDNLALLTALKDKYGKQQGMAVFNQLKWLVNPSAPTTIAARESAYPLKFDLQNTQTA

SEQ ID NO: 1887 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaatggataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1888 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEMDNLALLTALKDKYGKQQGMAVFNQLKWLVNPSAPTTIAARESAYPLKFDLQNTQTA

SEQ ID NO: 1889 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcaaattcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1890 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFKFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1891 - DNA, 2295 bp, Artificial Sequence; identical to SEQ ID NO: 1863
  Penicillin-G Acylates Variant from K. citrophila

SEQ ID NO: 1892 - protein, 764 aa, Artificial Sequence; identical to SEQ ID NO: 1864
  Penicillin-G Acylates Variant from K. citrophila

SEQ ID NO: 1893 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttccgtttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1894 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFRFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1895 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgttggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1896 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTVGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1897 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggcgtaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1898 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGRTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1899 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcagtagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1900 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSSSEIDNLALLTALKDKYGKQQGMAVFNQLKWLVNPSAPTTIAARESAYPLKFDLQNTQTA

SEQ ID NO: 1901 - DNA, 2295 bp, Artificial Sequence; identical to SEQ ID NO: 1899
  Penicillin-G Acylates Variant from K. citrophila

SEQ ID NO: 1902 - protein, 764 aa, Artificial Sequence; identical to SEQ ID NO: 1900
  Penicillin-G Acylates Variant from K. citrophila
